United States Patent 8,716,465 (KIT FOR MAKING INDUCED PLURIPOTENT STEM CELLS USING MODIFIED RNAS) - sequence listing, part 3

SEQ ID NO: 1500 - DNA, 7311 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa

SEQ ID NO: 1501 - DNA, 2520 bp, Homo sapiens
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaa
